United States Patent 11,872,280 (RNA VACCINE AGAINST SARS-COV-2 VARIANTS) - sequence listing, part 3

SEQ ID NO: 28564 - protein, 1267 aa, Artificial Sequence
  SARS-CoV-2/Wuhan/WIV05/2019__EPI_ISL_402128 spike protein (1-1273)(K986P_V987P_T19R_V70F_G142D_E156G_F157del_R158del_A222V_ K417N_L452R_T478K_D614G_P681R_R682del_R683del_A684del_R685del_D95 0N)
MFVFLVLLPLVSSQCVNLRTRTQLPPAYTNSFTRGVYYPDKVFRSSVLHSTQDLFLPFFSNVTWFHAIHFSGTNGTKRFDNPVLPFNDGVYFASTEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSVLEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28565 - protein, 1267 aa, Artificial Sequence
  SARS-CoV-2/Wuhan/WIV05/2019__EPI_ISL_402128 spike protein (1-1273)(K986P_V987P_T19R_T95I_G142D_E156G_F157del_R158del_L452R_ T478K_D614G_P681R_R682del_R683del_A684del_R685del_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28566 - protein, 1267 aa, Artificial Sequence
  SARS-CoV-2/Wuhan/WIV05/2019__EPI_ISL_402128 spike protein (1-1273)(K986P_V987P_T19R_E156G_F157del_R158del_L452R_T478K_D614G _P681R_R682del_R683del_A684del_R685del_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28567 - protein, 1267 aa, Artificial Sequence
  SARS-CoV-2/Wuhan/WIV05/2019__EPI_ISL_402128 spike protein (1-1273)(K986P_V987P_T19R_T95I_G142D_Y145H_E156G_F157del_R158del_ A222V_L452R_T478K_D614G_P681R_R682del_R683del_A684del_R685del_D95 0N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLDVYHHKNNKSWMESGVYSSANNCTFEYVSQPFLMDLEGKQGNFKNLREFVFKNIDGYFKIYSKHTPINLVRDLPQGFSVLEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28568 - protein, 1269 aa, Artificial Sequence
  SARS-CoV-2/Wuhan/WIV05/2019__EPI_ISL_402128 spike protein (1-1273)(K986P_V987P_T19R_L452R_E484Q_D614G_P681R_R682del_R683del _A684del_R685del_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVQGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28569 - protein, 1273 aa, Artificial Sequence
  SARS-CoV-2/Wuhan/WIV05/2019__EPI_ISL_402128 spike protein (1-1273)(K986P_V987P_L452R_E484K_D614G_P681R)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28570 - protein, 1273 aa, Artificial Sequence
  SARS-CoV-2/Wuhan/WIV05/2019__EPI_ISL_402128 spike protein (1-1273)(K986P_V987P_E154K_L452R_E484K_D614G_P681R_Q1071H)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMKSEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAHEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28571 - protein, 1271 aa, Artificial Sequence
  SARS-CoV-2/Wuhan/WIV05/2019__EPI_ISL_402128 spike protein (1-1273)(K986P_V987P_T19R_F157del_R158del_L452R_T478K_E484K_D614G _P681R_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28572 - protein, 1271 aa, Artificial Sequence
  SARS-CoV-2/Wuhan/WIV05/2019__EPI_ISL_402128 spike protein (1-1273)(K986P_V987P_T19R_G142D_E156G_F157del_R158del_L452R_T478K _E484K_D614G_P681R_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28573 - protein, 1271 aa, Artificial Sequence
  SARS-CoV-2/Wuhan/WIV05/2019__EPI_ISL_402128 spike protein (1-1273)(K986P_V987P_T19R_T95I_G142D_E156G_F157del_R158del_W258L_ K417N_L452R_T478K_E484K_D614G_P681R_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYRYRLFRKSNLKPFERDISTEIYQAGSKPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28574 - protein, 1271 aa, Artificial Sequence
  SARS-CoV-2/Wuhan/WIV05/2019__EPI_ISL_402128 spike protein (1-1273)(K986P_V987P_T19R_V70F_G142D_E156G_F157del_R158del_A222V_ K417N_L452R_T478K_E484K_D614G_P681R_D950N)
MFVFLVLLPLVSSQCVNLRTRTQLPPAYTNSFTRGVYYPDKVFRSSVLHSTQDLFLPFFSNVTWFHAIHFSGTNGTKRFDNPVLPFNDGVYFASTEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSVLEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYRYRLFRKSNLKPFERDISTEIYQAGSKPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28575 - protein, 1271 aa, Artificial Sequence
  SARS-CoV-2/Wuhan/WIV05/2019__EPI_ISL_402128 spike protein (1-1273)(K986P_V987P_T19R_T95I_G142D_E156G_F157del_R158del_L452R_ T478K_E484K_D614G_P681R_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28576 - protein, 1271 aa, Artificial Sequence
  SARS-CoV-2/Wuhan/WIV05/2019__EPI_ISL_402128 spike protein (1-1273)(K986P_V987P_T19R_E156G_F157del_R158del_L452R_T478K_E484K _D614G_P681R_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28577 - protein, 1271 aa, Artificial Sequence
  SARS-CoV-2/Wuhan/WIV05/2019__EPI_ISL_402128 spike protein (1-1273)(K986P_V987P_T19R_T95I_G142D_Y145H_E156G_F157del_R158del_ A222V_L452R_T478K_E484K_D614G_P681R_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLDVYHHKNNKSWMESGVYSSANNCTFEYVSQPFLMDLEGKQGNFKNLREFVFKNIDGYFKIYSKHTPINLVRDLPQGFSVLEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28578 - protein, 1273 aa, Artificial Sequence
  SARS-CoV-2/Wuhan/WIV05/2019__EPI_ISL_402128 spike protein (1-1273)(K986P_V987P_T19R_L452R_E484K_D614G_P681R_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28579 - protein, 1269 aa, Artificial Sequence
  SARS-CoV-2/Wuhan/WIV05/2019__EPI_ISL_402128 spike protein (1-1273)(K986P_V987P_L452R_E484K_D614G_P681R_R682del_R683del_A684 del_R685del)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28580 - protein, 1269 aa, Artificial Sequence
  SARS-CoV-2/Wuhan/WIV05/2019__EPI_ISL_402128 spike protein (1-1273)(K986P_V987P_E154K_L452R_E484K_D614G_P681R_R682del_R683de l_A684del_R685del_Q1071H)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMKSEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAHEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28581 - protein, 1267 aa, Artificial Sequence
  SARS-CoV-2/Wuhan/WIV05/2019__EPI_ISL_402128 spike protein (1-1273)(K986P_V987P_T19R_F157del_R158del_L452R_T478K_E484K_D614G _P681R_R682del_R683del_A684del_R685del_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28582 - protein, 1267 aa, Artificial Sequence
  SARS-CoV-2/Wuhan/WIV05/2019__EPI_ISL_402128 spike protein (1-1273)(K986P_V987P_T19R_G142D_E156G_F157del_R158del_L452R_T478K _E484K_D614G_P681R_R682del_R683del_A684del_R685del_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28583 - protein, 1267 aa, Artificial Sequence
  SARS-CoV-2/Wuhan/WIV05/2019__EPI_ISL_402128 spike protein (1-1273)(K986P_V987P_T19R_T95I_G142D_E156G_F157del_R158del_W258L_ K417N_L452R_T478K_E484K_D614G_P681R_R682del_R683del_A684del_R685d el_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYRYRLFRKSNLKPFERDISTEIYQAGSKPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28584 - protein, 1267 aa, Artificial Sequence
  SARS-CoV-2/Wuhan/WIV05/2019__EPI_ISL_402128 spike protein (1-1273)(K986P_V987P_T19R_V70F_G142D_E156G_F157del_R158del_A222V_ K417N_L452R_T478K_E484K_D614G_P681R_R682del_R683del_A684del_R685d el_D950N)
MFVFLVLLPLVSSQCVNLRTRTQLPPAYTNSFTRGVYYPDKVFRSSVLHSTQDLFLPFFSNVTWFHAIHFSGTNGTKRFDNPVLPFNDGVYFASTEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSVLEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYRYRLFRKSNLKPFERDISTEIYQAGSKPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28585 - protein, 1267 aa, Artificial Sequence
  SARS-CoV-2/Wuhan/WIV05/2019__EPI_ISL_402128 spike protein (1-1273)(K986P_V987P_T19R_T95I_G142D_E156G_F157del_R158del_L452R_ T478K_E484K_D614G_P681R_R682del_R683del_A684del_R685del_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28586 - protein, 1267 aa, Artificial Sequence
  SARS-CoV-2/Wuhan/WIV05/2019__EPI_ISL_402128 spike protein (1-1273)(K986P_V987P_T19R_E156G_F157del_R158del_L452R_T478K_E484K _D614G_P681R_R682del_R683del_A684del_R685del_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28587 - protein, 1267 aa, Artificial Sequence
  SARS-CoV-2/Wuhan/WIV05/2019__EPI_ISL_402128 spike protein (1-1273)(K986P_V987P_T19R_T95I_G142D_Y145H_E156G_F157del_R158del_ A222V_L452R_T478K_E484K_D614G_P681R_R682del_R683del_A684del_R685d el_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLDVYHHKNNKSWMESGVYSSANNCTFEYVSQPFLMDLEGKQGNFKNLREFVFKNIDGYFKIYSKHTPINLVRDLPQGFSVLEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28588 - protein, 1269 aa, Artificial Sequence
  SARS-CoV-2/Wuhan/WIV05/2019__EPI_ISL_402128 spike protein (1-1273)(K986P_V987P_T19R_L452R_E484K_D614G_P681R_R682del_R683del _A684del_R685del_D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28589 - RNA, 3813 nt, Artificial Sequence
  SARS-CoV-2/Wuhan/WIV05/2019__EPI_ISL_402128 spike protein cds gc (1-1273)(K986P_V987P_P9L_C136F_Y144del_R190S_D215G_L242del_A243de l_Y449H_E484K_N501Y_D614G_H655Y_N679K_T716I_T859N)
auguucguguuccugguccuccugcugcuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucuucaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaaccacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaaguccccgcggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28590 - RNA, 3813 nt, Artificial Sequence
  SARS-CoV-2/Wuhan/WIV05/2019__EPI_ISL_402128 spike protein cds gc (1-1273)(K986P_V987P_BA.1_v1)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28591 - RNA, 3813 nt, Artificial Sequence
  SARS-CoV-2/Wuhan/WIV05/2019__EPI_ISL_402128 spike protein cds gc (1-1273)(K986P_V987P_BA.1_v0)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaagcucgacuccaaggucagcggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28592 - RNA, 3822 nt, Artificial Sequence
  SARS-CoV-2/Wuhan/WIV05/2019__EPI_ISL_402128 spike protein cds gc (1-1273)(K986P_V987P_B.1.1.529)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28593 - RNA, 3813 nt, Artificial Sequence
  SARS-CoV-2/Wuhan/WIV05/2019__EPI_ISL_402128 spike protein cds gc (1-1273)(K986P_V987P_BA.2)
auguucguguuccugguccuccugccccuggugagcucccagugcgugaaccucaucacccgcacgcagagcuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugggccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaacuucgcccccuucuucgccuucaagugcuacggcgucagccccaccaagcucaacgaccugugcuucaccaacguguacgccgacuccuucgugauccgcgggaacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacggguuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28594 - RNA, 3801 nt, Artificial Sequence
  SARS-CoV-2/Wuhan/WIV05/2019__EPI_ISL_402128 spike protein cds gc (1-1273)(K986P_V987P_G75V_T76I_R246del_S247del_Y248del_L249del_T2 50del_P251del_G252del_D253N_L452Q_F490S_D614G_T859N)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcacaacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccaguaccgccuguuccgcaagagcaaccucaagcccuucgagcgggacaucuccaccgagaucuaccaggccggcagcacccccugcaacgggguggagggcuucaacugcuacagcccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28595 - RNA, 3822 nt, Artificial Sequence
  SARS-CoV-2/Wuhan/WIV05/2019__EPI_ISL_402128 spike protein cds gc (1-1273)(K986P_V987P_T95I_Y144S_Y145N_R346K_E484K_N501Y_D614G_P68 1H_D950N)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugagcaaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccaaguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28596 - RNA, 3816 nt, Artificial Sequence
  SARS-CoV-2/Wuhan/WIV05/2019__EPI_ISL_402128 spike protein cds gc (1-1273)(K986P_V987P_S12F_H69del_V70del_W152R_R346S_L452R_D614G_Q 677H_A899S)
auguucguguuccugguccuccugccccugguguucucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagccgcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccagcuucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucagcaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28597 - RNA, 3822 nt, Artificial Sequence
  SARS-CoV-2/Wuhan/WIV05/2019__EPI_ISL_402128 spike protein cds gc (1-1273)(K986P_V987P_I210T_N440K_E484K_D614G_D936N_S939F_T1027I)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaccaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaagcucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccagaacucccuguucuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28598 - RNA, 3822 nt, Artificial Sequence
  SARS-CoV-2/Wuhan/WIV05/2019__EPI_ISL_402128 spike protein cds gc (1-1273)(K986P_V987P_W152L_E484K_D614G_G769V)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagccugauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggugaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28599 - RNA, 3822 nt, Artificial Sequence
  SARS-CoV-2/Wuhan/WIV05/2019__EPI_ISL_402128 spike protein cds gc (1-1273)(K986P_V987P_T20I_R357K_D614G)
auguucguguuccugguccuccugccccuggugagcucccagugcgugaaccucaccauccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagaagaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28600 - RNA, 3819 nt, Artificial Sequence
  SARS-CoV-2/Wuhan/WIV05/2019__EPI_ISL_402128 spike protein cds gc (1-1273)(K986P_V987P_T95I_Y144del_E484K_D614G_P681H_D796H)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaagcacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28601 - RNA, 3816 nt, Artificial Sequence
  SARS-CoV-2/Wuhan/WIV05/2019__EPI_ISL_402128 spike protein cds gc (1-1273)(K986P_V987P_T19R_G142D_E156G_F157del_R158del_L452R_T478K _D614G_P681R_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28602 - RNA, 3816 nt, Artificial Sequence
  SARS-CoV-2/Wuhan/WIV05/2019__EPI_ISL_402128 spike protein cds gc (1-1273)(K986P_V987P_T19R_T95I_G142D_E156G_F157del_R158del_W258L_ K417N_L452R_T478K_D614G_P681R_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28603 - RNA, 3816 nt, Artificial Sequence
  SARS-CoV-2/Wuhan/WIV05/2019__EPI_ISL_402128 spike protein cds gc (1-1273)(K986P_V987P_T19R_V70F_G142D_E156G_F157del_R158del_A222V_ K417N_L452R_T478K_D614G_P681R_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28604 - RNA, 3816 nt, Artificial Sequence
  SARS-CoV-2/Wuhan/WIV05/2019__EPI_ISL_402128 spike protein cds gc (1-1273)(K986P_V987P_T19R_T95I_G142D_E156G_F157del_R158del_L452R_ T478K_D614G_P681R_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28605 - RNA, 3816 nt, Artificial Sequence
  SARS-CoV-2/Wuhan/WIV05/2019__EPI_ISL_402128 spike protein cds gc (1-1273)(K986P_V987P_T19R_E156G_F157del_R158del_L452R_T478K_D614G _P681R_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28606 - RNA, 3816 nt, Artificial Sequence
  SARS-CoV-2/Wuhan/WIV05/2019__EPI_ISL_402128 spike protein cds gc (1-1273)(K986P_V987P_T19R_T95I_G142D_Y145H_E156G_F157del_R158del_ A222V_L452R_T478K_D614G_P681R_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28607 - RNA, 3822 nt, Artificial Sequence
  SARS-CoV-2/Wuhan/WIV05/2019__EPI_ISL_402128 spike protein cds gc (1-1273)(K986P_V987P_T19R_L452R_E484Q_D614G_P681R_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28608 - RNA, 3810 nt, Artificial Sequence
  SARS-CoV-2/Wuhan/WIV05/2019__EPI_ISL_402128 spike protein cds gc (1-1273)(K986P_V987P_L452R_D614G_P681R_R682del_R683del_A684del_R6 85del)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28609 - RNA, 3810 nt, Artificial Sequence
  SARS-CoV-2/Wuhan/WIV05/2019__EPI_ISL_402128 spike protein cds gc (1-1273)(K986P_V987P_E154K_L452R_E484Q_D614G_P681R_R682del_R683de l_A684del_R685del_Q1071H)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28610 - RNA, 3804 nt, Artificial Sequence
  SARS-CoV-2/Wuhan/WIV05/2019__EPI_ISL_402128 spike protein cds gc (1-1273)(K986P_V987P_T19R_F157del_R158del_L452R_T478K_D614G_P681R _R682del_R683del_A684del_R685del_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28611 - RNA, 3804 nt, Artificial Sequence
  SARS-CoV-2/Wuhan/WIV05/2019__EPI_ISL_402128 spike protein cds gc (1-1273)(K986P_V987P_T19R_G142D_E156G_F157del_R158del_L452R_T478K _D614G_P681R_R682del_R683del_A684del_R685del_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28612 - RNA, 3804 nt, Artificial Sequence
  SARS-CoV-2/Wuhan/WIV05/2019__EPI_ISL_402128 spike protein cds gc (1-1273)(K986P_V987P_T19R_T95I_G142D_E156G_F157del_R158del_W258L_ K417N_L452R_T478K_D614G_P681R_R682del_R683del_A684del_R685del_D95 0N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28613 - RNA, 3804 nt, Artificial Sequence
  SARS-CoV-2/Wuhan/WIV05/2019__EPI_ISL_402128 spike protein cds gc (1-1273)(K986P_V987P_T19R_V70F_G142D_E156G_F157del_R158del_A222V_ K417N_L452R_T478K_D614G_P681R_R682del_R683del_A684del_R685del_D95 0N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28614 - RNA, 3804 nt, Artificial Sequence
  SARS-CoV-2/Wuhan/WIV05/2019__EPI_ISL_402128 spike protein cds gc (1-1273)(K986P_V987P_T19R_T95I_G142D_E156G_F157del_R158del_L452R_ T478K_D614G_P681R_R682del_R683del_A684del_R685del_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28615 - RNA, 3804 nt, Artificial Sequence
  SARS-CoV-2/Wuhan/WIV05/2019__EPI_ISL_402128 spike protein cds gc (1-1273)(K986P_V987P_T19R_E156G_F157del_R158del_L452R_T478K_D614G _P681R_R682del_R683del_A684del_R685del_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28616 - RNA, 3804 nt, Artificial Sequence
  SARS-CoV-2/Wuhan/WIV05/2019__EPI_ISL_402128 spike protein cds gc (1-1273)(K986P_V987P_T19R_T95I_G142D_Y145H_E156G_F157del_R158del_ A222V_L452R_T478K_D614G_P681R_R682del_R683del_A684del_R685del_D95 0N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28617 - RNA, 3810 nt, Artificial Sequence
  SARS-CoV-2/Wuhan/WIV05/2019__EPI_ISL_402128 spike protein cds gc (1-1273)(K986P_V987P_T19R_L452R_E484Q_D614G_P681R_R682del_R683del _A684del_R685del_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28618 - RNA, 3822 nt, Artificial Sequence
  SARS-CoV-2/Wuhan/WIV05/2019__EPI_ISL_402128 spike protein cds gc (1-1273)(K986P_V987P_L452R_E484K_D614G_P681R)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28619 - RNA, 3822 nt, Artificial Sequence
  SARS-CoV-2/Wuhan/WIV05/2019__EPI_ISL_402128 spike protein cds gc (1-1273)(K986P_V987P_E154K_L452R_E484K_D614G_P681R_Q1071H)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28620 - RNA, 3816 nt, Artificial Sequence
  SARS-CoV-2/Wuhan/WIV05/2019__EPI_ISL_402128 spike protein cds gc (1-1273)(K986P_V987P_T19R_F157del_R158del_L452R_T478K_E484K_D614G _P681R_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28621 - RNA, 3816 nt, Artificial Sequence
  SARS-CoV-2/Wuhan/WIV05/2019__EPI_ISL_402128 spike protein cds gc (1-1273)(K986P_V987P_T19R_G142D_E156G_F157del_R158del_L452R_T478K _E484K_D614G_P681R_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28622 - RNA, 3816 nt, Artificial Sequence
  SARS-CoV-2/Wuhan/WIV05/2019__EPI_ISL_402128 spike protein cds gc (1-1273)(K986P_V987P_T19R_T95I_G142D_E156G_F157del_R158del_W258L_ K417N_L452R_T478K_E484K_D614G_P681R_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28623 - RNA, 3816 nt, Artificial Sequence
  SARS-CoV-2/Wuhan/WIV05/2019__EPI_ISL_402128 spike protein cds gc (1-1273)(K986P_V987P_T19R_V70F_G142D_E156G_F157del_R158del_A222V_ K417N_L452R_T478K_E484K_D614G_P681R_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28624 - RNA, 3816 nt, Artificial Sequence
  SARS-CoV-2/Wuhan/WIV05/2019__EPI_ISL_402128 spike protein cds gc (1-1273)(K986P_V987P_T19R_T95I_G142D_E156G_F157del_R158del_L452R_ T478K_E484K_D614G_P681R_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28625 - RNA, 3816 nt, Artificial Sequence
  SARS-CoV-2/Wuhan/WIV05/2019__EPI_ISL_402128 spike protein cds gc (1-1273)(K986P_V987P_T19R_E156G_F157del_R158del_L452R_T478K_E484K _D614G_P681R_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28626 - RNA, 3816 nt, Artificial Sequence
  SARS-CoV-2/Wuhan/WIV05/2019__EPI_ISL_402128 spike protein cds gc (1-1273)(K986P_V987P_T19R_T95I_G142D_Y145H_E156G_F157del_R158del_ A222V_L452R_T478K_E484K_D614G_P681R_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28627 - RNA, 3822 nt, Artificial Sequence
  SARS-CoV-2/Wuhan/WIV05/2019__EPI_ISL_402128 spike protein cds gc (1-1273)(K986P_V987P_T19R_L452R_E484K_D614G_P681R_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28628 - RNA, 3810 nt, Artificial Sequence
  SARS-CoV-2/Wuhan/WIV05/2019__EPI_ISL_402128 spike protein cds gc (1-1273)(K986P_V987P_L452R_E484K_D614G_P681R_R682del_R683del_A684 del_R685del)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28629 - RNA, 3810 nt, Artificial Sequence
  SARS-CoV-2/Wuhan/WIV05/2019__EPI_ISL_402128 spike protein cds gc (1-1273)(K986P_V987P_E154K_L452R_E484K_D614G_P681R_R682del_R683de l_A684del_R685del_Q1071H)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28630 - RNA, 3804 nt, Artificial Sequence
  SARS-CoV-2/Wuhan/WIV05/2019__EPI_ISL_402128 spike protein cds gc (1-1273)(K986P_V987P_T19R_F157del_R158del_L452R_T478K_E484K_D614G _P681R_R682del_R683del_A684del_R685del_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28631 - RNA, 3804 nt, Artificial Sequence
  SARS-CoV-2/Wuhan/WIV05/2019__EPI_ISL_402128 spike protein cds gc (1-1273)(K986P_V987P_T19R_G142D_E156G_F157del_R158del_L452R_T478K _E484K_D614G_P681R_R682del_R683del_A684del_R685del_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28632 - RNA, 3804 nt, Artificial Sequence
  SARS-CoV-2/Wuhan/WIV05/2019__EPI_ISL_402128 spike protein cds gc (1-1273)(K986P_V987P_T19R_T95I_G142D_E156G_F157del_R158del_W258L_ K417N_L452R_T478K_E484K_D614G_P681R_R682del_R683del_A684del_R685d el_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28633 - RNA, 3804 nt, Artificial Sequence
  SARS-CoV-2/Wuhan/WIV05/2019__EPI_ISL_402128 spike protein cds gc (1-1273)(K986P_V987P_T19R_V70F_G142D_E156G_F157del_R158del_A222V_ K417N_L452R_T478K_E484K_D614G_P681R_R682del_R683del_A684del_R685d el_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28634 - RNA, 3804 nt, Artificial Sequence
  SARS-CoV-2/Wuhan/WIV05/2019__EPI_ISL_402128 spike protein cds gc (1-1273)(K986P_V987P_T19R_T95I_G142D_E156G_F157del_R158del_L452R_ T478K_E484K_D614G_P681R_R682del_R683del_A684del_R685del_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28635 - RNA, 3804 nt, Artificial Sequence
  SARS-CoV-2/Wuhan/WIV05/2019__EPI_ISL_402128 spike protein cds gc (1-1273)(K986P_V987P_T19R_E156G_F157del_R158del_L452R_T478K_E484K _D614G_P681R_R682del_R683del_A684del_R685del_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28636 - RNA, 3804 nt, Artificial Sequence
  SARS-CoV-2/Wuhan/WIV05/2019__EPI_ISL_402128 spike protein cds gc (1-1273)(K986P_V987P_T19R_T95I_G142D_Y145H_E156G_F157del_R158del_ A222V_L452R_T478K_E484K_D614G_P681R_R682del_R683del_A684del_R685d el_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28637 - RNA, 3810 nt, Artificial Sequence
  SARS-CoV-2/Wuhan/WIV05/2019__EPI_ISL_402128 spike protein cds gc (1-1273)(K986P_V987P_T19R_L452R_E484K_D614G_P681R_R682del_R683del _A684del_R685del_D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28638 - RNA, 4085 nt, Artificial Sequence
  SARS-CoV-2/Wuhan/WIV05/2019__EPI_ISL_402128 spike protein mRNA gc (1-1273)(K986P_V987P_P9L_C136F_Y144del_R190S_D215G_L242del_A243de l_Y449H_E484K_N501Y_D614G_H655Y_N679K_T716I_T859N) R10922
aggagagucccgcagucggcguccagcggcucugcuuguucgugugugugucguugcaggccuuauucaagcuuaccauguucguguuccugguccuccugcugcuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucuucaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaaccacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaaguccccgcggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28639 - RNA, 4085 nt, Artificial Sequence
  SARS-CoV-2/Wuhan/WIV05/2019__EPI_ISL_402128 spike protein mRNA gc (1-1273)(K986P_V987P_BA.1_v1) R11175
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28640 - RNA, 4085 nt, Artificial Sequence
  SARS-CoV-2/Wuhan/WIV05/2019__EPI_ISL_402128 spike protein mRNA gc (1-1273)(K986P_V987P_BA.1_v0) R11113
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaagcucgacuccaaggucagcggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28641 - RNA, 4094 nt, Artificial Sequence
  SARS-CoV-2/Wuhan/WIV05/2019__EPI_ISL_402128 spike protein mRNA gc (1-1273)(K986P_V987P_B.1.1.529)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28642 - RNA, 4085 nt, Artificial Sequence
  SARS-CoV-2/Wuhan/WIV05/2019__EPI_ISL_402128 spike protein mRNA gc (1-1273)(K986P_V987P_BA.2)
aggagagucccgcagucggcguccagcggcucugcuuguucgugugugugucguugcaggccuuauucaagcuuaccauguucguguuccugguccuccugccccuggugagcucccagugcgugaaccucaucacccgcacgcagagcuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugggccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaacuucgcccccuucuucgccuucaagugcuacggcgucagccccaccaagcucaacgaccugugcuucaccaacguguacgccgacuccuucgugauccgcgggaacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacggguuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28643 - RNA, 4073 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_D253N_L452Q_F490S_D614G_T859N) P5508
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcacaacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccaguaccgccuguuccgcaagagcaaccucaagcccuucgagcgggacaucuccaccgagaucuaccaggccggcagcacccccugcaacgggguggagggcuucaacugcuacagcccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28644 - RNA, 4094 nt, Artificial Sequence
  SARS-CoV-2/Wuhan/WIV05/2019__EPI_ISL_402128 spike protein mRNA gc (1-1273)(K986P_V987P_T95I_Y144S_Y145N_R346K_E484K_N501Y_D614G_P68 1H_D950N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugagcaaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccaaguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28645 - RNA, 4088 nt, Artificial Sequence
  SARS-CoV-2/Wuhan/WIV05/2019__EPI_ISL_402128 spike protein mRNA gc (1-1273)(K986P_V987P_S12F_H69del_V70del_W152R_R346S_L452R_D614G_Q 677H_A899S) P5453
aggagagucccgcagucggcguccagcggcucugcuuguucgugugugugucguugcaggccuuauucaagcuuaccauguucguguuccugguccuccugccccugguguucucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagccgcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccagcuucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucagcaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28646 - RNA, 4094 nt, Artificial Sequence
  SARS-CoV-2/Wuhan/WIV05/2019__EPI_ISL_402128 spike protein mRNA gc (1-1273)(K986P_V987P_I210T_N440K_E484K_D614G_D936N_S939F_T1027I) P5507
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaccaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaagcucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccagaacucccuguucuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28647 - RNA, 4094 nt, Artificial Sequence
  SARS-CoV-2/Wuhan/WIV05/2019__EPI_ISL_402128 spike protein mRNA gc (1-1273)(K986P_V987P_W152L_E484K_D614G_G769V) P5509
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagccugauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggugaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28648 - RNA, 4094 nt, Artificial Sequence
  SARS-CoV-2/Wuhan/WIV05/2019__EPI_ISL_402128 spike protein mRNA gc (1-1273)(K986P_V987P_T20I_R357K_D614G) P5572
aggagagucccgcagucggcguccagcggcucugcuuguucgugugugugucguugcaggccuuauucaagcuuaccauguucguguuccugguccuccugccccuggugagcucccagugcgugaaccucaccauccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagaagaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28649 - RNA, 4091 nt, Artificial Sequence
  SARS-CoV-2/Wuhan/WIV05/2019__EPI_ISL_402128 spike protein mRNA gc (1-1273)(K986P_V987P_T95I_Y144del_E484K_D614G_P681H_D796H) P5664
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaagcacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28650 - RNA, 4088 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _D614G_P681R_D950N) R10884
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28651 - RNA, 4088 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_D614G_P681R_D950N) R10801
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28652 - RNA, 4088 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_D614G_P681R_D950N) R10802
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28653 - RNA, 4088 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_D614G_P681R_D950N) P5662
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28654 - RNA, 4088 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_D614G _P681R_D950N) P5663
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28655 - RNA, 4088 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_D614G_P681R_D950N) R11036
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28656 - RNA, 4094 nt, Artificial Sequence
  SARS-CoV-2/Wuhan/WIV05/2019__EPI_ISL_402128 spike protein mRNA gc (1-1273)(K986P_V987P_T19R_L452R_E484Q_D614G_P681R_D950N) P5454
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28657 - RNA, 4082 nt, Artificial Sequence
  SARS-CoV-2/Wuhan/WIV05/2019__EPI_ISL_402128 spike protein mRNA gc (1-1273)(K986P_V987P_L452R_D614G_P681R_R682del_R683del_A684del_R6 85del)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28658 - RNA, 4082 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_R682del_R683de l_A684del_R685del_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28659 - RNA, 4076 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28660 - RNA, 4076 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28661 - RNA, 4076 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_D614G_P681R_R682del_R683del_A684del_R685del_D95 0N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28662 - RNA, 4076 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_D614G_P681R_R682del_R683del_A684del_R685del_D95 0N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28663 - RNA, 4076 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28664 - RNA, 4076 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_D614G _P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28665 - RNA, 4076 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_D614G_P681R_R682del_R683del_A684del_R685del_D95 0N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28666 - RNA, 4082 nt, Artificial Sequence
  SARS-CoV-2/Wuhan/WIV05/2019__EPI_ISL_402128 spike protein mRNA gc (1-1273)(K986P_V987P_T19R_L452R_E484Q_D614G_P681R_R682del_R683del _A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28667 - RNA, 4094 nt, Artificial Sequence
  SARS-CoV-2/Wuhan/WIV05/2019__EPI_ISL_402128 spike protein mRNA gc (1-1273)(K986P_V987P_L452R_E484K_D614G_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28668 - RNA, 4094 nt, Artificial Sequence
  SARS-CoV-2/Wuhan/WIV05/2019__EPI_ISL_402128 spike protein mRNA gc (1-1273)(K986P_V987P_E154K_L452R_E484K_D614G_P681R_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28669 - RNA, 4088 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_E484K_D614G _P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28670 - RNA, 4088 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28671 - RNA, 4088 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28672 - RNA, 4088 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28673 - RNA, 4088 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28674 - RNA, 4088 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_E484K _D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28675 - RNA, 4088 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28676 - RNA, 4094 nt, Artificial Sequence
  SARS-CoV-2/Wuhan/WIV05/2019__EPI_ISL_402128 spike protein mRNA gc (1-1273)(K986P_V987P_T19R_L452R_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28677 - RNA, 4082 nt, Artificial Sequence
  SARS-CoV-2/Wuhan/WIV05/2019__EPI_ISL_402128 spike protein mRNA gc (1-1273)(K986P_V987P_L452R_E484K_D614G_P681R_R682del_R683del_A684 del_R685del)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28678 - RNA, 4082 nt, Artificial Sequence
  SARS-CoV-2/Wuhan/WIV05/2019__EPI_ISL_402128 spike protein mRNA gc (1-1273)(K986P_V987P_E154K_L452R_E484K_D614G_P681R_R682del_R683de l_A684del_R685del_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28679 - RNA, 4076 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_E484K_D614G _P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28680 - RNA, 4076 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _E484K_D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28681 - RNA, 4076 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_E484K_D614G_P681R_R682del_R683del_A684del_R685d el_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28682 - RNA, 4076 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_E484K_D614G_P681R_R682del_R683del_A684del_R685d el_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28683 - RNA, 4076 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_E484K_D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28684 - RNA, 4076 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_E484K _D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28685 - RNA, 4076 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_E484K_D614G_P681R_R682del_R683del_A684del_R685d el_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28686 - RNA, 4082 nt, Artificial Sequence
  SARS-CoV-2/Wuhan/WIV05/2019__EPI_ISL_402128 spike protein mRNA gc (1-1273)(K986P_V987P_T19R_L452R_E484K_D614G_P681R_R682del_R683del _A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28687 - RNA, 4061 nt, Artificial Sequence
  SARS-CoV-2/Wuhan/WIV05/2019__EPI_ISL_402128 spike protein mRNA gc (1-1273)(K986P_V987P_P9L_C136F_Y144del_R190S_D215G_L242del_A243de l_Y449H_E484K_N501Y_D614G_H655Y_N679K_T716I_T859N)
aggagagucccgcagucggcguccagcggcucugcuuguucgugugugugucguugcaggccuuauucaagcuuaccauguucguguuccugguccuccugcugcuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucuucaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaaccacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaaguccccgcggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28688 - RNA, 4061 nt, Artificial Sequence
  SARS-CoV-2/Wuhan/WIV05/2019__EPI_ISL_402128 spike protein mRNA gc (1-1273)(K986P_V987P_BA.1_v1)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28689 - RNA, 4061 nt, Artificial Sequence
  SARS-CoV-2/Wuhan/WIV05/2019__EPI_ISL_402128 spike protein mRNA gc (1-1273)(K986P_V987P_BA.1_v0)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaagcucgacuccaaggucagcggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28690 - RNA, 4070 nt, Artificial Sequence
  SARS-CoV-2/Wuhan/WIV05/2019__EPI_ISL_402128 spike protein mRNA gc (1-1273)(K986P_V987P_B.1.1.529)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28691 - RNA, 4061 nt, Artificial Sequence
  SARS-CoV-2/Wuhan/WIV05/2019__EPI_ISL_402128 spike protein mRNA gc (1-1273)(K986P_V987P_BA.2)
aggagagucccgcagucggcguccagcggcucugcuuguucgugugugugucguugcaggccuuauucaagcuuaccauguucguguuccugguccuccugccccuggugagcucccagugcgugaaccucaucacccgcacgcagagcuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugggccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaacuucgcccccuucuucgccuucaagugcuacggcgucagccccaccaagcucaacgaccugugcuucaccaacguguacgccgacuccuucgugauccgcgggaacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacggguuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28692 - RNA, 4049 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_D253N_L452Q_F490S_D614G_T859N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcacaacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccaguaccgccuguuccgcaagagcaaccucaagcccuucgagcgggacaucuccaccgagaucuaccaggccggcagcacccccugcaacgggguggagggcuucaacugcuacagcccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28693 - RNA, 4070 nt, Artificial Sequence
  SARS-CoV-2/Wuhan/WIV05/2019__EPI_ISL_402128 spike protein mRNA gc (1-1273)(K986P_V987P_T95I_Y144S_Y145N_R346K_E484K_N501Y_D614G_P68 1H_D950N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugagcaaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccaaguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28694 - RNA, 4064 nt, Artificial Sequence
  SARS-CoV-2/Wuhan/WIV05/2019__EPI_ISL_402128 spike protein mRNA gc (1-1273)(K986P_V987P_S12F_H69del_V70del_W152R_R346S_L452R_D614G_Q 677H_A899S)
aggagagucccgcagucggcguccagcggcucugcuuguucgugugugugucguugcaggccuuauucaagcuuaccauguucguguuccugguccuccugccccugguguucucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagccgcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccagcuucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucagcaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28695 - RNA, 4070 nt, Artificial Sequence
  SARS-CoV-2/Wuhan/WIV05/2019__EPI_ISL_402128 spike protein mRNA gc (1-1273)(K986P_V987P_I210T_N440K_E484K_D614G_D936N_S939F_T1027I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaccaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaagcucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccagaacucccuguucuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28696 - RNA, 4070 nt, Artificial Sequence
  SARS-CoV-2/Wuhan/WIV05/2019__EPI_ISL_402128 spike protein mRNA gc (1-1273)(K986P_V987P_W152L_E484K_D614G_G769V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagccugauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggugaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28697 - RNA, 4070 nt, Artificial Sequence
  SARS-CoV-2/Wuhan/WIV05/2019__EPI_ISL_402128 spike protein mRNA gc (1-1273)(K986P_V987P_T20I_R357K_D614G)
aggagagucccgcagucggcguccagcggcucugcuuguucgugugugugucguugcaggccuuauucaagcuuaccauguucguguuccugguccuccugccccuggugagcucccagugcgugaaccucaccauccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagaagaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28698 - RNA, 4067 nt, Artificial Sequence
  SARS-CoV-2/Wuhan/WIV05/2019__EPI_ISL_402128 spike protein mRNA gc (1-1273)(K986P_V987P_T95I_Y144del_E484K_D614G_P681H_D796H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaagcacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28699 - RNA, 4064 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28700 - RNA, 4064 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_D614G_P681R_D950N) R10829
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28701 - RNA, 4064 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28702 - RNA, 4064 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28703 - RNA, 4064 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_D614G _P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28704 - RNA, 4064 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28705 - RNA, 4070 nt, Artificial Sequence
  SARS-CoV-2/Wuhan/WIV05/2019__EPI_ISL_402128 spike protein mRNA gc (1-1273)(K986P_V987P_T19R_L452R_E484Q_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28706 - RNA, 4058 nt, Artificial Sequence
  SARS-CoV-2/Wuhan/WIV05/2019__EPI_ISL_402128 spike protein mRNA gc (1-1273)(K986P_V987P_L452R_D614G_P681R_R682del_R683del_A684del_R6 85del)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28707 - RNA, 4058 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_R682del_R683de l_A684del_R685del_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28708 - RNA, 4052 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28709 - RNA, 4052 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28710 - RNA, 4052 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_D614G_P681R_R682del_R683del_A684del_R685del_D95 0N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28711 - RNA, 4052 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_D614G_P681R_R682del_R683del_A684del_R685del_D95 0N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28712 - RNA, 4052 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28713 - RNA, 4052 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_D614G _P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28714 - RNA, 4052 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_D614G_P681R_R682del_R683del_A684del_R685del_D95 0N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28715 - RNA, 4058 nt, Artificial Sequence
  SARS-CoV-2/Wuhan/WIV05/2019__EPI_ISL_402128 spike protein mRNA gc (1-1273)(K986P_V987P_T19R_L452R_E484Q_D614G_P681R_R682del_R683del _A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28716 - RNA, 4070 nt, Artificial Sequence
  SARS-CoV-2/Wuhan/WIV05/2019__EPI_ISL_402128 spike protein mRNA gc (1-1273)(K986P_V987P_L452R_E484K_D614G_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28717 - RNA, 4070 nt, Artificial Sequence
  SARS-CoV-2/Wuhan/WIV05/2019__EPI_ISL_402128 spike protein mRNA gc (1-1273)(K986P_V987P_E154K_L452R_E484K_D614G_P681R_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28718 - RNA, 4064 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_E484K_D614G _P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28719 - RNA, 4064 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28720 - RNA, 4064 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28721 - RNA, 4064 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28722 - RNA, 4064 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28723 - RNA, 4064 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_E484K _D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28724 - RNA, 4064 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28725 - RNA, 4070 nt, Artificial Sequence
  SARS-CoV-2/Wuhan/WIV05/2019__EPI_ISL_402128 spike protein mRNA gc (1-1273)(K986P_V987P_T19R_L452R_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28726 - RNA, 4058 nt, Artificial Sequence
  SARS-CoV-2/Wuhan/WIV05/2019__EPI_ISL_402128 spike protein mRNA gc (1-1273)(K986P_V987P_L452R_E484K_D614G_P681R_R682del_R683del_A684 del_R685del)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28727 - RNA, 4058 nt, Artificial Sequence
  SARS-CoV-2/Wuhan/WIV05/2019__EPI_ISL_402128 spike protein mRNA gc (1-1273)(K986P_V987P_E154K_L452R_E484K_D614G_P681R_R682del_R683de l_A684del_R685del_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28728 - RNA, 4052 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_E484K_D614G _P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28729 - RNA, 4052 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _E484K_D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28730 - RNA, 4052 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_E484K_D614G_P681R_R682del_R683del_A684del_R685d el_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28731 - RNA, 4052 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_E484K_D614G_P681R_R682del_R683del_A684del_R685d el_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28732 - RNA, 4052 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_E484K_D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28733 - RNA, 4052 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_E484K _D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28734 - RNA, 4052 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_E484K_D614G_P681R_R682del_R683del_A684del_R685d el_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28735 - RNA, 4058 nt, Artificial Sequence
  SARS-CoV-2/Wuhan/WIV05/2019__EPI_ISL_402128 spike protein mRNA gc (1-1273)(K986P_V987P_T19R_L452R_E484K_D614G_P681R_R682del_R683del _A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28736 - RNA, 4100 nt, Artificial Sequence
  SARS-CoV-2/Wuhan/WIV05/2019__EPI_ISL_402128 spike protein mRNA gc (1-1273)(K986P_V987P) R10820, R10821
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28737 - RNA, 4100 nt, Artificial Sequence
  SARS-CoV-2/Wuhan/WIV05/2019__EPI_ISL_402128 spike protein mRNA gc (1-1273)(K986P_V987P_ D614G) R10812, R10813
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28738 - RNA, 4100 nt, Artificial Sequence
  SARS-CoV-2/Wuhan/WIV05/2019__EPI_ISL_402128 spike protein mRNA gc (1-1273)(K986P_V987P_A222V_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28739 - RNA, 4100 nt, Artificial Sequence
  SARS-CoV-2/Wuhan/WIV05/2019__EPI_ISL_402128 spike protein mRNA gc (1-1273)(K986P_V987P_N439K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28740 - RNA, 4100 nt, Artificial Sequence
  SARS-CoV-2/Wuhan/WIV05/2019__EPI_ISL_402128 spike protein mRNA gc (1-1273)(K986P_V987P_S477N_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28741 - RNA, 4100 nt, Artificial Sequence
  SARS-CoV-2/Wuhan/WIV05/2019__EPI_ISL_402128 spike protein mRNA gc (1-1273)(K986P_V987P_N501Y_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28742 - RNA, 4094 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28743 - RNA, 4100 nt, Artificial Sequence
  SARS-CoV-2/Wuhan/WIV05/2019__EPI_ISL_402128 spike protein mRNA gc (1-1273)(K986P_V987P_Y453F_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28744 - RNA, 4100 nt, Artificial Sequence
  SARS-CoV-2/Wuhan/WIV05/2019__EPI_ISL_402128 spike protein mRNA gc (1-1273)(K986P_V987P_D614G_I692V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28745 - RNA, 4100 nt, Artificial Sequence
  SARS-CoV-2/Wuhan/WIV05/2019__EPI_ISL_402128 spike protein mRNA gc (1-1273)(K986P_V987P_D614G_M1229I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28746 - RNA, 4094 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28747 - RNA, 4094 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28748 - RNA, 4091 nt, Artificial Sequence
  SARS-CoV-2/Wuhan/WIV05/2019__EPI_ISL_402128 spike protein mRNA gc (1-1273)(K986P_V987P_H69del_V70del_Y144del_N501Y_A570D_D614G_P681 H_T716I_S982A_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28749 - RNA, 4100 nt, Artificial Sequence
  SARS-CoV-2/Wuhan/WIV05/2019__EPI_ISL_402128 spike protein mRNA gc (1-1273)(K986P_V987P_K417N_E484K_N501Y_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28750 - RNA, 4091 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_R246 I_K417N_E484K_N501Y_D614G_A701V)
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28751 - RNA, 4100 nt, Artificial Sequence
  SARS-CoV-2/Wuhan/WIV05/2019__EPI_ISL_402128 spike protein mRNA gc (1-1273)(K986P_V987P_E484K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28752 - RNA, 4100 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I)
aggagagucccgcagucggcguccagcggcucugcuuguucgugugugugucguugcaggccuuauucaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28753 - RNA, 4100 nt, Artificial Sequence
  SARS-CoV-2/Wuhan/WIV05/2019__EPI_ISL_402128 spike protein mRNA gc (1-1273)(K986P_V987P_S13I_W152C_L452R_D614G)
aggagagucccgcagucggcguccagcggcucugcuuguucgugugugugucguugcaggccuuauucaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28754 - RNA, 4091 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28755 - RNA, 4091 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacagguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28756 - RNA, 4091 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccgcgaccucuuccugcccuucuucagcaacgucacgugguuccacgugaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggacccugggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28757 - RNA, 4091 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggacccugggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28758 - RNA, 4100 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagagucccgcagucggcguccagcggcucugcuuguucgugugugugucguugcaggccuuauucaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28759 - RNA, 4100 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28760 - RNA, 4100 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28761 - RNA, 4100 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28762 - RNA, 4094 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N) R10827, R10828, R11043, R11160, R11161
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28763 - RNA, 4079 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcacgacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccaguaccgccuguuccgcaagagcaaccucaagcccuucgagcgggacaucuccaccgagaucuaccaggccggcagcacccccugcaacgggguggagggcuucaacugcuacagcccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28764 - RNA, 4094 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28765 - RNA, 4100 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagagucccgcagucggcguccagcggcucugcuuguucgugugugugucguugcaggccuuauucaagcuuaccauguucguguucuucguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccggggggcagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28766 - RNA, 4100 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagagucccgcagucggcguccagcggcucugcuuguucgugugugugucguugcaggccuuauucaagcuuaccauguucguguucuucguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccggggggcagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccgcgcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28767 - RNA, 4100 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgagcugcgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcuuccuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccacgacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28768 - RNA, 4100 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacuucagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggugaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28769 - RNA, 4082 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacgccgucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccucuaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28770 - RNA, 4103 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugaccagcaaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccaaguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28771 - RNA, 4109 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggaccgaccgcgaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggcaagaccgggaagaucgccgacuacaacuacaagcugccggacgacuucacgggcugcgugaucgcguggaacagcaacaaccucgacuccaaggucgggggcaacuacaaguaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28772 - RNA, 4100 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcauggccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28773 - RNA, 4100 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcaagggcguguucguguccaacgggaccuacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28774 - RNA, 4094 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguucgacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucguggugcacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggccgagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccagcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcgcgacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccuggacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28775 - RNA, 4097 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28776 - RNA, 4094 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugcacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28777 - RNA, 4091 nt, Artificial Sequence
  SARS-CoV-2/Wuhan/WIV05/2019__EPI_ISL_402128 spike protein mRNA gc (1-1273)(K986P_V987P_P9L_C136F_Y144del_R190S_D215G_L242del_A243de l_Y449H_E484K_N501Y_D614G_H655Y_N679K_T716I_T859N)
aggagagucccgcagucggcguccagcggcucugcuuguucgugugugugucguugcaggccuuauucaagcuuaccauguucguguuccugguccuccugcugcuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucuucaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaaccacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaaguccccgcggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28778 - RNA, 4091 nt, Artificial Sequence
  SARS-CoV-2/Wuhan/WIV05/2019__EPI_ISL_402128 spike protein mRNA gc (1-1273)(K986P_V987P_BA.1_v1) R11176, R11177, R11178
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28779 - RNA, 4091 nt, Artificial Sequence
  SARS-CoV-2/Wuhan/WIV05/2019__EPI_ISL_402128 spike protein mRNA gc (1-1273)(K986P_V987P_BA.1_v0) R11114, R11115, R11116
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaagcucgacuccaaggucagcggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28780 - RNA, 4100 nt, Artificial Sequence
  SARS-CoV-2/Wuhan/WIV05/2019__EPI_ISL_402128 spike protein mRNA gc (1-1273)(K986P_V987P_B.1.1.529)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28781 - RNA, 4091 nt, Artificial Sequence
  SARS-CoV-2/Wuhan/WIV05/2019__EPI_ISL_402128 spike protein mRNA gc (1-1273)(K986P_V987P_BA.2)
aggagagucccgcagucggcguccagcggcucugcuuguucgugugugugucguugcaggccuuauucaagcuuaccauguucguguuccugguccuccugccccuggugagcucccagugcgugaaccucaucacccgcacgcagagcuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugggccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaacuucgcccccuucuucgccuucaagugcuacggcgucagccccaccaagcucaacgaccugugcuucaccaacguguacgccgacuccuucgugauccgcgggaacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacggguuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28782 - RNA, 4079 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_D253N_L452Q_F490S_D614G_T859N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcacaacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccaguaccgccuguuccgcaagagcaaccucaagcccuucgagcgggacaucuccaccgagaucuaccaggccggcagcacccccugcaacgggguggagggcuucaacugcuacagcccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28783 - RNA, 4100 nt, Artificial Sequence
  SARS-CoV-2/Wuhan/WIV05/2019__EPI_ISL_402128 spike protein mRNA gc (1-1273)(K986P_V987P_T95I_Y144S_Y145N_R346K_E484K_N501Y_D614G_P68 1H_D950N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugagcaaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccaaguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28784 - RNA, 4094 nt, Artificial Sequence
  SARS-CoV-2/Wuhan/WIV05/2019__EPI_ISL_402128 spike protein mRNA gc (1-1273)(K986P_V987P_S12F_H69del_V70del_W152R_R346S_L452R_D614G_Q 677H_A899S)
aggagagucccgcagucggcguccagcggcucugcuuguucgugugugugucguugcaggccuuauucaagcuuaccauguucguguuccugguccuccugccccugguguucucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagccgcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccagcuucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucagcaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28785 - RNA, 4100 nt, Artificial Sequence
  SARS-CoV-2/Wuhan/WIV05/2019__EPI_ISL_402128 spike protein mRNA gc (1-1273)(K986P_V987P_I210T_N440K_E484K_D614G_D936N_S939F_T1027I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaccaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaagcucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccagaacucccuguucuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28786 - RNA, 4100 nt, Artificial Sequence
  SARS-CoV-2/Wuhan/WIV05/2019__EPI_ISL_402128 spike protein mRNA gc (1-1273)(K986P_V987P_W152L_E484K_D614G_G769V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagccugauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggugaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28787 - RNA, 4100 nt, Artificial Sequence
  SARS-CoV-2/Wuhan/WIV05/2019__EPI_ISL_402128 spike protein mRNA gc (1-1273)(K986P_V987P_T20I_R357K_D614G)
aggagagucccgcagucggcguccagcggcucugcuuguucgugugugugucguugcaggccuuauucaagcuuaccauguucguguuccugguccuccugccccuggugagcucccagugcgugaaccucaccauccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagaagaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28788 - RNA, 4097 nt, Artificial Sequence
  SARS-CoV-2/Wuhan/WIV05/2019__EPI_ISL_402128 spike protein mRNA gc (1-1273)(K986P_V987P_T95I_Y144del_E484K_D614G_P681H_D796H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaagcacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28789 - RNA, 4094 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28790 - RNA, 4094 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_D614G_P681R_D950N) R10832, R10833
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28791 - RNA, 4094 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28792 - RNA, 4094 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28793 - RNA, 4094 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_D614G _P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28794 - RNA, 4094 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28795 - RNA, 4100 nt, Artificial Sequence
  SARS-CoV-2/Wuhan/WIV05/2019__EPI_ISL_402128 spike protein mRNA gc (1-1273)(K986P_V987P_T19R_L452R_E484Q_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28796 - RNA, 4088 nt, Artificial Sequence
  SARS-CoV-2/Wuhan/WIV05/2019__EPI_ISL_402128 spike protein mRNA gc (1-1273)(K986P_V987P_L452R_D614G_P681R_R682del_R683del_A684del_R6 85del)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28797 - RNA, 4088 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_R682del_R683de l_A684del_R685del_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28798 - RNA, 4082 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28799 - RNA, 4082 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28800 - RNA, 4082 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_D614G_P681R_R682del_R683del_A684del_R685del_D95 0N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28801 - RNA, 4082 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_D614G_P681R_R682del_R683del_A684del_R685del_D95 0N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28802 - RNA, 4082 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28803 - RNA, 4082 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_D614G _P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28804 - RNA, 4082 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_D614G_P681R_R682del_R683del_A684del_R685del_D95 0N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28805 - RNA, 4088 nt, Artificial Sequence
  SARS-CoV-2/Wuhan/WIV05/2019__EPI_ISL_402128 spike protein mRNA gc (1-1273)(K986P_V987P_T19R_L452R_E484Q_D614G_P681R_R682del_R683del _A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28806 - RNA, 4100 nt, Artificial Sequence
  SARS-CoV-2/Wuhan/WIV05/2019__EPI_ISL_402128 spike protein mRNA gc (1-1273)(K986P_V987P_L452R_E484K_D614G_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28807 - RNA, 4100 nt, Artificial Sequence
  SARS-CoV-2/Wuhan/WIV05/2019__EPI_ISL_402128 spike protein mRNA gc (1-1273)(K986P_V987P_E154K_L452R_E484K_D614G_P681R_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28808 - RNA, 4094 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_E484K_D614G _P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28809 - RNA, 4094 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28810 - RNA, 4094 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28811 - RNA, 4094 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28812 - RNA, 4094 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28813 - RNA, 4094 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_E484K _D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28814 - RNA, 4094 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28815 - RNA, 4100 nt, Artificial Sequence
  SARS-CoV-2/Wuhan/WIV05/2019__EPI_ISL_402128 spike protein mRNA gc (1-1273)(K986P_V987P_T19R_L452R_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28816 - RNA, 4088 nt, Artificial Sequence
  SARS-CoV-2/Wuhan/WIV05/2019__EPI_ISL_402128 spike protein mRNA gc (1-1273)(K986P_V987P_L452R_E484K_D614G_P681R_R682del_R683del_A684 del_R685del)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28817 - RNA, 4088 nt, Artificial Sequence
  SARS-CoV-2/Wuhan/WIV05/2019__EPI_ISL_402128 spike protein mRNA gc (1-1273)(K986P_V987P_E154K_L452R_E484K_D614G_P681R_R682del_R683de l_A684del_R685del_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28818 - RNA, 4082 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_E484K_D614G _P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28819 - RNA, 4082 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _E484K_D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28820 - RNA, 4082 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_E484K_D614G_P681R_R682del_R683del_A684del_R685d el_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28821 - RNA, 4082 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_E484K_D614G_P681R_R682del_R683del_A684del_R685d el_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28822 - RNA, 4082 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_E484K_D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28823 - RNA, 4082 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_E484K _D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28824 - RNA, 4082 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_E484K_D614G_P681R_R682del_R683del_A684del_R685d el_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28825 - RNA, 4088 nt, Artificial Sequence
  SARS-CoV-2/Wuhan/WIV05/2019__EPI_ISL_402128 spike protein mRNA gc (1-1273)(K986P_V987P_T19R_L452R_E484K_D614G_P681R_R682del_R683del _A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28826 - RNA, 4076 nt, Artificial Sequence
  SARS-CoV-2/Wuhan/WIV05/2019__EPI_ISL_402128 spike protein mRNA gc (1-1273)(K986P_V987P) R10822, R10823
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28827 - RNA, 4076 nt, Artificial Sequence
  SARS-CoV-2/Wuhan/WIV05/2019__EPI_ISL_402128 spike protein mRNA gc (1-1273)(K986P_V987P_ D614G) R10814, R10815
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28828 - RNA, 4076 nt, Artificial Sequence
  SARS-CoV-2/Wuhan/WIV05/2019__EPI_ISL_402128 spike protein mRNA gc (1-1273)(K986P_V987P_A222V_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28829 - RNA, 4076 nt, Artificial Sequence
  SARS-CoV-2/Wuhan/WIV05/2019__EPI_ISL_402128 spike protein mRNA gc (1-1273)(K986P_V987P_N439K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28830 - RNA, 4076 nt, Artificial Sequence
  SARS-CoV-2/Wuhan/WIV05/2019__EPI_ISL_402128 spike protein mRNA gc (1-1273)(K986P_V987P_S477N_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28831 - RNA, 4076 nt, Artificial Sequence
  SARS-CoV-2/Wuhan/WIV05/2019__EPI_ISL_402128 spike protein mRNA gc (1-1273)(K986P_V987P_N501Y_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28832 - RNA, 4070 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28833 - RNA, 4076 nt, Artificial Sequence
  SARS-CoV-2/Wuhan/WIV05/2019__EPI_ISL_402128 spike protein mRNA gc (1-1273)(K986P_V987P_Y453F_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28834 - RNA, 4076 nt, Artificial Sequence
  SARS-CoV-2/Wuhan/WIV05/2019__EPI_ISL_402128 spike protein mRNA gc (1-1273)(K986P_V987P_D614G_I692V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28835 - RNA, 4076 nt, Artificial Sequence
  SARS-CoV-2/Wuhan/WIV05/2019__EPI_ISL_402128 spike protein mRNA gc (1-1273)(K986P_V987P_D614G_M1229I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28836 - RNA, 4070 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28837 - RNA, 4070 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28838 - RNA, 4067 nt, Artificial Sequence
  SARS-CoV-2/Wuhan/WIV05/2019__EPI_ISL_402128 spike protein mRNA gc (1-1273)(K986P_V987P_H69del_V70del_Y144del_N501Y_A570D_D614G_P681 H_T716I_S982A_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28839 - RNA, 4076 nt, Artificial Sequence
  SARS-CoV-2/Wuhan/WIV05/2019__EPI_ISL_402128 spike protein mRNA gc (1-1273)(K986P_V987P_K417N_E484K_N501Y_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28840 - RNA, 4067 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_R246 I_K417N_E484K_N501Y_D614G_A701V)
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28841 - RNA, 4076 nt, Artificial Sequence
  SARS-CoV-2/Wuhan/WIV05/2019__EPI_ISL_402128 spike protein mRNA gc (1-1273)(K986P_V987P_E484K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28842 - RNA, 4076 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I)
aggagagucccgcagucggcguccagcggcucugcuuguucgugugugugucguugcaggccuuauucaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28843 - RNA, 4076 nt, Artificial Sequence
  SARS-CoV-2/Wuhan/WIV05/2019__EPI_ISL_402128 spike protein mRNA gc (1-1273)(K986P_V987P_S13I_W152C_L452R_D614G)
aggagagucccgcagucggcguccagcggcucugcuuguucgugugugugucguugcaggccuuauucaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28844 - RNA, 4067 nt, Artificial Sequence
  SARS-CoV-2/Wuhan/WIV05/2019__EPI_ISL_402128 spike protein mRNA gc (1-1273)(K986P_V987P_H69del_V70del_Y144del_E484K_N501Y_A570D_D614 G_P681H_T716I_S982A_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28845 - RNA, 4067 nt, Artificial Sequence
  SARS-CoV-2/Wuhan/WIV05/2019__EPI_ISL_402128 spike protein mRNA gc (1-1273)(K986P_V987P_L18F_D80A_D215G_L242del_A243del_L244del_K417 N_E484K_N501Y_D614G_A701V)
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacagguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28846 - RNA, 4067 nt, Artificial Sequence
  SARS-CoV-2/Wuhan/WIV05/2019__EPI_ISL_402128 spike protein mRNA gc (1-1273)(K986P_V987P_Q52R_A67V_H69del_V70del_Y144del_E484K_D614G_ Q677H_F888L)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccgcgaccucuuccugcccuucuucagcaacgucacgugguuccacgugaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggacccugggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28847 - RNA, 4067 nt, Artificial Sequence
  SARS-CoV-2/Wuhan/WIV05/2019__EPI_ISL_402128 spike protein mRNA gc (1-1273)(K986P_V987P_A67V_H69del_V70del_Y144del_E484K_D614G_Q677H _F888L)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggacccugggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28848 - RNA, 4076 nt, Artificial Sequence
  SARS-CoV-2/Wuhan/WIV05/2019__EPI_ISL_402128 spike protein mRNA gc (1-1273)(K986P_V987P_L18F_T20N_P26S_D138Y_R190S_K417T_E484K_N501Y _D614G_H655Y_T1027I_V1176F)
aggagagucccgcagucggcguccagcggcucugcuuguucgugugugugucguugcaggccuuauucaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28849 - RNA, 4076 nt, Artificial Sequence
  SARS-CoV-2/Wuhan/WIV05/2019__EPI_ISL_402128 spike protein mRNA gc (1-1273)(K986P_V987P_E484K_D614G_V1176F)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28850 - RNA, 4076 nt, Artificial Sequence
  SARS-CoV-2/Wuhan/WIV05/2019__EPI_ISL_402128 spike protein mRNA gc (1-1273)(K986P_V987P_L452R_D614G_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28851 - RNA, 4076 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28852 - RNA, 4070 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _D950N) R10825, R10826
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28853 - RNA, 4055 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_L452Q_F490S_D614G_T859N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcacgacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccaguaccgccuguuccgcaagagcaaccucaagcccuucgagcgggacaucuccaccgagaucuaccaggccggcagcacccccugcaacgggguggagggcuucaacugcuacagcccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28854 - RNA, 4070 nt, Artificial Sequence
  SARS-CoV-2/Wuhan/WIV05/2019__EPI_ISL_402128 spike protein mRNA gc (1-1273)(K986P_V987P_H69del_V70del_N439K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28855 - RNA, 4076 nt, Artificial Sequence
  SARS-CoV-2/Wuhan/WIV05/2019__EPI_ISL_402128 spike protein mRNA gc (1-1273)(K986P_V987P_L5F_T95I_D253G_E484K_D614G_A701V)
aggagagucccgcagucggcguccagcggcucugcuuguucgugugugugucguugcaggccuuauucaagcuuaccauguucguguucuucguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccggggggcagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28856 - RNA, 4076 nt, Artificial Sequence
  SARS-CoV-2/Wuhan/WIV05/2019__EPI_ISL_402128 spike protein mRNA gc (1-1273)(K986P_V987P_L5F_T95I_D253G_S477N_D614G_Q957R)
aggagagucccgcagucggcguccagcggcucugcuuguucgugugugugucguugcaggccuuauucaagcuuaccauguucguguucuucguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccggggggcagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccgcgcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28857 - RNA, 4076 nt, Artificial Sequence
  SARS-CoV-2/Wuhan/WIV05/2019__EPI_ISL_402128 spike protein mRNA gc (1-1273)(K986P_V987P_F157L_V367F_Q613H_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgagcugcgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcuuccuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccacgacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28858 - RNA, 4076 nt, Artificial Sequence
  SARS-CoV-2/Wuhan/WIV05/2019__EPI_ISL_402128 spike protein mRNA gc (1-1273)(K986P_V987P_S254F_D614G_P681R_G769V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacuucagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggugaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28859 - RNA, 4058 nt, Artificial Sequence
  SARS-CoV-2/Wuhan/WIV05/2019__EPI_ISL_402128 spike protein mRNA gc (1-1273)(K986P_V987P_P26S_H69del_V70del_V126A_Y144del_L242del_A24 3del_L244del_H245Y_S477N_E484K_D614G_P681H_T1027I_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacgccgucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccucuaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28860 - RNA, 4079 nt, Artificial Sequence
  SARS-CoV-2/Wuhan/WIV05/2019__EPI_ISL_402128 spike protein mRNA gc (1-1273)(K986P_V987P_T95I_Y144T_Y145S_ins145N_R346K_E484K_N501Y_D 614G_P681H_D950N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugaccagcaaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccaaguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28861 - RNA, 4085 nt, Artificial Sequence
  SARS-CoV-2/Wuhan/WIV05/2019__EPI_ISL_402128 spike protein mRNA gc (1-1273)(K986P_V987P_ins214TDR_Q414K_N450K_D614G_T716I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggaccgaccgcgaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggcaagaccgggaagaucgccgacuacaacuacaagcugccggacgacuucacgggcugcgugaucgcguggaacagcaacaaccucgacuccaaggucgggggcaacuacaaguaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28862 - RNA, 4076 nt, Artificial Sequence
  SARS-CoV-2/Wuhan/WIV05/2019__EPI_ISL_402128 spike protein mRNA gc (1-1273)(K986P_V987P_T478K_D614G_P681H_T732A)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcauggccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28863 - RNA, 4076 nt, Artificial Sequence
  SARS-CoV-2/Wuhan/WIV05/2019__EPI_ISL_402128 spike protein mRNA gc (1-1273)(K986P_V987P_E484K_N501Y_D614G_P681H_E1092K_H1101Y_V1176F )
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcaagggcguguucguguccaacgggaccuacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28864 - RNA, 4070 nt, Artificial Sequence
  SARS-CoV-2/Wuhan/WIV05/2019__EPI_ISL_402128 spike protein mRNA gc (1-1273)(K986P_V987P_H66D_G142V_Y144del_Y145del_D215G_V483A_D614G _H655Y_G669S_Q949R_N1187D)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguucgacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucguggugcacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggccgagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccagcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcgcgacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccuggacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28865 - RNA, 4073 nt, Artificial Sequence
  SARS-CoV-2/Wuhan/WIV05/2019__EPI_ISL_402128 spike protein mRNA gc (1-1273)(K986P_V987P_Y144del_L452R_T478K_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28866 - RNA, 4070 nt, Artificial Sequence
  SARS-CoV-2/Wuhan/WIV05/2019__EPI_ISL_402128 spike protein mRNA gc (1-1273)(K986P_V987P_T19R_Y144del_Y145del_L452R_T478K_D614G_P681R )
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugcacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28867 - RNA, 4067 nt, Artificial Sequence
  SARS-CoV-2/Wuhan/WIV05/2019__EPI_ISL_402128 spike protein mRNA gc (1-1273)(K986P_V987P_P9L_C136F_Y144del_R190S_D215G_L242del_A243de l_Y449H_E484K_N501Y_D614G_H655Y_N679K_T716I_T859N)
aggagagucccgcagucggcguccagcggcucugcuuguucgugugugugucguugcaggccuuauucaagcuuaccauguucguguuccugguccuccugcugcuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucuucaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaaccacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaaguccccgcggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28868 - RNA, 4067 nt, Artificial Sequence
  SARS-CoV-2/Wuhan/WIV05/2019__EPI_ISL_402128 spike protein mRNA gc (1-1273)(K986P_V987P_BA.1_v1)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28869 - RNA, 4067 nt, Artificial Sequence
  SARS-CoV-2/Wuhan/WIV05/2019__EPI_ISL_402128 spike protein mRNA gc (1-1273)(K986P_V987P_BA.1_v0)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaagcucgacuccaaggucagcggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28870 - RNA, 4076 nt, Artificial Sequence
  SARS-CoV-2/Wuhan/WIV05/2019__EPI_ISL_402128 spike protein mRNA gc (1-1273)(K986P_V987P_B.1.1.529)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28871 - RNA, 4067 nt, Artificial Sequence
  SARS-CoV-2/Wuhan/WIV05/2019__EPI_ISL_402128 spike protein mRNA gc (1-1273)(K986P_V987P_BA.2)
aggagagucccgcagucggcguccagcggcucugcuuguucgugugugugucguugcaggccuuauucaagcuuaccauguucguguuccugguccuccugccccuggugagcucccagugcgugaaccucaucacccgcacgcagagcuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugggccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaacuucgcccccuucuucgccuucaagugcuacggcgucagccccaccaagcucaacgaccugugcuucaccaacguguacgccgacuccuucgugauccgcgggaacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacggguuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28872 - RNA, 4055 nt, Artificial Sequence
  SARS-CoV-2/Wuhan/WIV05/2019__EPI_ISL_402128 spike protein mRNA gc (1-1273)(K986P_V987P_G75V_T76I_R246del_S247del_Y248del_L249del_T2 50del_P251del_G252del_D253N_L452Q_F490S_D614G_T859N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcacaacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccaguaccgccuguuccgcaagagcaaccucaagcccuucgagcgggacaucuccaccgagaucuaccaggccggcagcacccccugcaacgggguggagggcuucaacugcuacagcccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28873 - RNA, 4076 nt, Artificial Sequence
  SARS-CoV-2/Wuhan/WIV05/2019__EPI_ISL_402128 spike protein mRNA gc (1-1273)(K986P_V987P_T95I_Y144S_Y145N_R346K_E484K_N501Y_D614G_P68 1H_D950N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugagcaaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccaaguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28874 - RNA, 4070 nt, Artificial Sequence
  SARS-CoV-2/Wuhan/WIV05/2019__EPI_ISL_402128 spike protein mRNA gc (1-1273)(K986P_V987P_S12F_H69del_V70del_W152R_R346S_L452R_D614G_Q 677H_A899S)
aggagagucccgcagucggcguccagcggcucugcuuguucgugugugugucguugcaggccuuauucaagcuuaccauguucguguuccugguccuccugccccugguguucucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagccgcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccagcuucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucagcaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28875 - RNA, 4076 nt, Artificial Sequence
  SARS-CoV-2/Wuhan/WIV05/2019__EPI_ISL_402128 spike protein mRNA gc (1-1273)(K986P_V987P_I210T_N440K_E484K_D614G_D936N_S939F_T1027I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaccaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaagcucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccagaacucccuguucuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28876 - RNA, 4076 nt, Artificial Sequence
  SARS-CoV-2/Wuhan/WIV05/2019__EPI_ISL_402128 spike protein mRNA gc (1-1273)(K986P_V987P_W152L_E484K_D614G_G769V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagccugauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggugaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28877 - RNA, 4076 nt, Artificial Sequence
  SARS-CoV-2/Wuhan/WIV05/2019__EPI_ISL_402128 spike protein mRNA gc (1-1273)(K986P_V987P_T20I_R357K_D614G)
aggagagucccgcagucggcguccagcggcucugcuuguucgugugugugucguugcaggccuuauucaagcuuaccauguucguguuccugguccuccugccccuggugagcucccagugcgugaaccucaccauccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagaagaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28878 - RNA, 4073 nt, Artificial Sequence
  SARS-CoV-2/Wuhan/WIV05/2019__EPI_ISL_402128 spike protein mRNA gc (1-1273)(K986P_V987P_T95I_Y144del_E484K_D614G_P681H_D796H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaagcacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28879 - RNA, 4070 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28880 - RNA, 4070 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_D614G_P681R_D950N) R10830, R10831
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28881 - RNA, 4070 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28882 - RNA, 4070 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28883 - RNA, 4070 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_D614G _P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28884 - RNA, 4070 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28885 - RNA, 4076 nt, Artificial Sequence
  SARS-CoV-2/Wuhan/WIV05/2019__EPI_ISL_402128 spike protein mRNA gc (1-1273)(K986P_V987P_T19R_L452R_E484Q_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28886 - RNA, 4064 nt, Artificial Sequence
  SARS-CoV-2/Wuhan/WIV05/2019__EPI_ISL_402128 spike protein mRNA gc (1-1273)(K986P_V987P_L452R_D614G_P681R_R682del_R683del_A684del_R6 85del)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28887 - RNA, 4064 nt, Artificial Sequence
  SARS-CoV-2/Wuhan/WIV05/2019__EPI_ISL_402128 spike protein mRNA gc (1-1273)(K986P_V987P_E154K_L452R_E484Q_D614G_P681R_R682del_R683de l_A684del_R685del_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28888 - RNA, 4058 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_D614G_P681R _R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28889 - RNA, 4058 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28890 - RNA, 4058 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_D614G_P681R_R682del_R683del_A684del_R685del_D95 0N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28891 - RNA, 4058 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_D614G_P681R_R682del_R683del_A684del_R685del_D95 0N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28892 - RNA, 4058 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28893 - RNA, 4058 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_D614G _P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28894 - RNA, 4058 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_D614G_P681R_R682del_R683del_A684del_R685del_D95 0N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28895 - RNA, 4064 nt, Artificial Sequence
  SARS-CoV-2/Wuhan/WIV05/2019__EPI_ISL_402128 spike protein mRNA gc (1-1273)(K986P_V987P_T19R_L452R_E484Q_D614G_P681R_R682del_R683del _A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28896 - RNA, 4076 nt, Artificial Sequence
  SARS-CoV-2/Wuhan/WIV05/2019__EPI_ISL_402128 spike protein mRNA gc (1-1273)(K986P_V987P_L452R_E484K_D614G_P681R)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28897 - RNA, 4076 nt, Artificial Sequence
  SARS-CoV-2/Wuhan/WIV05/2019__EPI_ISL_402128 spike protein mRNA gc (1-1273)(K986P_V987P_E154K_L452R_E484K_D614G_P681R_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28898 - RNA, 4070 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_E484K_D614G _P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28899 - RNA, 4070 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28900 - RNA, 4070 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28901 - RNA, 4070 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28902 - RNA, 4070 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28903 - RNA, 4070 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_E484K _D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28904 - RNA, 4070 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28905 - RNA, 4076 nt, Artificial Sequence
  SARS-CoV-2/Wuhan/WIV05/2019__EPI_ISL_402128 spike protein mRNA gc (1-1273)(K986P_V987P_T19R_L452R_E484K_D614G_P681R_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28906 - RNA, 4064 nt, Artificial Sequence
  SARS-CoV-2/Wuhan/WIV05/2019__EPI_ISL_402128 spike protein mRNA gc (1-1273)(K986P_V987P_L452R_E484K_D614G_P681R_R682del_R683del_A684 del_R685del)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28907 - RNA, 4064 nt, Artificial Sequence
  SARS-CoV-2/Wuhan/WIV05/2019__EPI_ISL_402128 spike protein mRNA gc (1-1273)(K986P_V987P_E154K_L452R_E484K_D614G_P681R_R682del_R683de l_A684del_R685del_Q1071H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28908 - RNA, 4058 nt, Artificial Sequence
  SARS-CoV-2/Wuhan/WIV05/2019__EPI_ISL_402128 spike protein mRNA gc (1-1273)(K986P_V987P_T19R_F157del_R158del_L452R_T478K_E484K_D614G _P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28909 - RNA, 4058 nt, Artificial Sequence
  SARS-CoV-2/Wuhan/WIV05/2019__EPI_ISL_402128 spike protein mRNA gc (1-1273)(K986P_V987P_T19R_G142D_E156G_F157del_R158del_L452R_T478K _E484K_D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28910 - RNA, 4058 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_W258L_ K417N_L452R_T478K_E484K_D614G_P681R_R682del_R683del_A684del_R685d el_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28911 - RNA, 4058 nt, Artificial Sequence
  SARS-CoV-2/Wuhan/WIV05/2019__EPI_ISL_402128 spike protein mRNA gc (1-1273)(K986P_V987P_T19R_V70F_G142D_E156G_F157del_R158del_A222V_ K417N_L452R_T478K_E484K_D614G_P681R_R682del_R683del_A684del_R685d el_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacuucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28912 - RNA, 4058 nt, Artificial Sequence
  SARS-CoV-2/Wuhan/WIV05/2019__EPI_ISL_402128 spike protein mRNA gc (1-1273)(K986P_V987P_T19R_T95I_G142D_E156G_F157del_R158del_L452R_ T478K_E484K_D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28913 - RNA, 4058 nt, Artificial Sequence
  SARS-CoV-2/Wuhan/WIV05/2019__EPI_ISL_402128 spike protein mRNA gc (1-1273)(K986P_V987P_T19R_E156G_F157del_R158del_L452R_T478K_E484K _D614G_P681R_R682del_R683del_A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28914 - RNA, 4058 nt, Artificial Sequence
  SARS-CoV-2/Wuhan/WIV05/2019__EPI_ISL_402128 spike protein mRNA gc (1-1273)(K986P_V987P_T19R_T95I_G142D_Y145H_E156G_F157del_R158del_ A222V_L452R_T478K_E484K_D614G_P681R_R682del_R683del_A684del_R685d el_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgacguguaccaccacaagaacaacaagagcuggauggaguccggcgucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28915 - RNA, 4064 nt, Artificial Sequence
  SARS-CoV-2/Wuhan/WIV05/2019__EPI_ISL_402128 spike protein mRNA gc (1-1273)(K986P_V987P_T19R_L452R_E484K_D614G_P681R_R682del_R683del _A684del_R685del_D950N)
aggagagucccgcagucggcguccagcggcucugcuuguucgugugugugucguugcaggccuuauucaagcuuaccauguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28916 - RNA, 3822 nt, Artificial Sequence
  SARS-CoV-2/Wuhan/WIV05/2019__EPI_ISL_402128__spike protein CDS wt (1-1273)(K986P_V987P)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacccuccugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 28917 - protein, 1270 aa, Artificial Sequence
  SARS-CoV-2/Wuhan/WIV05/2019__EPI_ISL_402128__spike protein (1-1273)(K986P_V987P_BA.1_v2)
MFVFLVLLPLVSSQCVNLTTRTQLPPAYTNSFTRGVYYPDKVFRSSVLHSTQDLFLPFFSNVTWFHVISGTNGTKRFDNPVLPFNDGVYFASIEKSNIIRGWIFGTTLDSKTQSLLIVNNATNVVIKVCEFQFCNDPFLDHKNNKSWMESEFRVYSSANNCTFEYVSQPFLMDLEGKQGNFKNLREFVFKNIDGYFKIYSKHTPIIVREPEDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNLAPFFTFKCYGVSPTKLNDLCFTNVYADSFVIRGDEVRQIAPGQTGKIADYNYKLPDDFTGCVIAWNSNKLDSKVGGNYNYLYRLFRKSNLKPFERDISTEIYQAGNKPCNGVAGFNCYFPLRSYSFRPTYGVGHQPYRVVVLSFELLHAPATVCGPKKSTNLVKNKCVNFNFNGLKGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFKGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDIFSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28918 - protein, 1270 aa, Artificial Sequence
  SARS-CoV-2/Wuhan/WIV05/2019__EPI_ISL_402128__spike protein (1-1273)(K986P_V987P_BA.1_v3)
MFVFLVLLPLVSSQCVNLTTRTQLPPAYTNSFTRGVYYPDKVFRSSVLHSTQDLFLPFFSNVTWFHVISGTNGTKRFDNPVLPFNDGVYFASIEKSNIIRGWIFGTTLDSKTQSLLIVNNATNVVIKVCEFQFCNDPFLDHKNNKSWMESEFRVYSSANNCTFEYVSQPFLMDLEGKQGNFKNLREFVFKNIDGYFKIYSKHTPIIVREPEDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNLAPFFTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNKPCNGVAGFNCYFPLRSYSFRPTYGVGHQPYRVVVLSFELLHAPATVCGPKKSTNLVKNKCVNFNFNGLKGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKYFGGFNFSQILPDPSKPSKRSFIEDLLFNKVTLADAGFIKQYGDCLGDIAARDLICAQKFKGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDIFSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28919 - protein, 1270 aa, Artificial Sequence
  SARS-CoV-2/Wuhan/WIV05/2019__EPI_ISL_402128__spike protein (1-1273)(K986P_V987P_BA.1_v4)
MFVFLVLLPLVSSQCVNLTTRTQLPPAYTNSFTRGVYYPDKVFRSSVLHSTQDLFLPFFSNVTWFHVISGTNGTKRFDNPVLPFNDGVYFASIEKSNIIRGWIFGTTLDSKTQSLLIVNNATNVVIKVCEFQFCNDPFLDHKNNKSWMESEFRVYSSANNCTFEYVSQPFLMDLEGKQGNFKNLREFVFKNIDGYFKIYSKHTPIIVREPEDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNLAPFFTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNKPCNGVAGFNCYFPLRSYSFRPTYGVGHQPYRVVVLSFELLHAPATVCGPKKSTNLVKNKCVNFNFNGLKGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGVENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFKGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDIFSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28920 - protein, 1270 aa, Artificial Sequence
  SARS-CoV-2/Wuhan/WIV05/2019__EPI_ISL_402128__spike protein (1-1273)(K986P_V987P_BA.1_v5)
MFVFLVLLPLVSSQCVNLTTRTQLPPAYTNSFTRGVYYPDKVFRSSVLHSTQDLFLPFFSNVTWFHVISGTNGTKRFDNPVLPFNDGVYFASIEKSNIIRGWIFGTTLDSKTQSLLIVNNATNVVIKVCEFQFCNDPFLDHKNNKSWMESEFRVYSSANNCTFEYVSQPFLMDLEGKQGNFKNLREFVFKNIDGYFKIYSKHTPIIVREPEDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNLAPFFTFKCYGVSPTKLNDLCFTNVYADSFVIRGDEVRQIAPGQTGKIADYNYKLPDDFTGCVIAWNSNNLDSKVSGNYNYLYRLFRKSNLKPFERDISTEIYQAGNKPCNGVAGFNCYFPLRSYSFRPTYGVGHQPYRVVVLSFELLHAPATVCGPKKSTNLVKNKCVNFNFNGLKGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFKGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDIFSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 28921 - RNA, 3813 nt, Artificial Sequence
  SARS-CoV-2/Wuhan/WIV05/2019__EPI_ISL_402128__spike protein cds gc (1-1273)(K986P_V987P_BA.1_v2)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaagcucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28922 - RNA, 3813 nt, Artificial Sequence
  SARS-CoV-2/Wuhan/WIV05/2019__EPI_ISL_402128__spike protein cds gc (1-1273)(K986P_V987P_BA.1_v3)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28923 - RNA, 3813 nt, Artificial Sequence
  SARS-CoV-2/Wuhan/WIV05/2019__EPI_ISL_402128__spike protein cds gc (1-1273)(K986P_V987P_BA.1_v4)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28924 - RNA, 3813 nt, Artificial Sequence
  SARS-CoV-2/Wuhan/WIV05/2019__EPI_ISL_402128__spike protein cds gc (1-1273)(K986P_V987P_BA.1_v5)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucagcggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 28925 - RNA, 4085 nt, Artificial Sequence
  SARS-CoV-2/Wuhan/WIV05/2019__EPI_ISL_402128 spike protein mRNA gc (1-1273)(K986P_V987P_BA.1_v2)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaagcucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28926 - RNA, 4085 nt, Artificial Sequence
  SARS-CoV-2/Wuhan/WIV05/2019__EPI_ISL_402128 spike protein mRNA gc (1-1273)(K986P_V987P_BA.1_v3)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28927 - RNA, 4085 nt, Artificial Sequence
  SARS-CoV-2/Wuhan/WIV05/2019__EPI_ISL_402128 spike protein mRNA gc (1-1273)(K986P_V987P_BA.1_v4)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28928 - RNA, 4085 nt, Artificial Sequence
  SARS-CoV-2/Wuhan/WIV05/2019__EPI_ISL_402128 spike protein mRNA gc (1-1273)(K986P_V987P_BA.1_v5)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucagcggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28929 - RNA, 4061 nt, Artificial Sequence
  SARS-CoV-2/Wuhan/WIV05/2019__EPI_ISL_402128 spike protein mRNA gc (1-1273)(K986P_V987P_BA.1_v2)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaagcucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28930 - RNA, 4061 nt, Artificial Sequence
  SARS-CoV-2/Wuhan/WIV05/2019__EPI_ISL_402128 spike protein mRNA gc (1-1273)(K986P_V987P_BA.1_v3)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28931 - RNA, 4061 nt, Artificial Sequence
  SARS-CoV-2/Wuhan/WIV05/2019__EPI_ISL_402128 spike protein mRNA gc (1-1273)(K986P_V987P_BA.1_v4)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28932 - RNA, 4061 nt, Artificial Sequence
  SARS-CoV-2/Wuhan/WIV05/2019__EPI_ISL_402128 spike protein mRNA gc (1-1273)(K986P_V987P_BA.1_v5)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucagcggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28933 - RNA, 4091 nt, Artificial Sequence
  SARS-CoV-2/Wuhan/WIV05/2019__EPI_ISL_402128 spike protein mRNA gc (1-1273)(K986P_V987P_BA.1_v2)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaagcucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28934 - RNA, 4091 nt, Artificial Sequence
  SARS-CoV-2/Wuhan/WIV05/2019__EPI_ISL_402128 spike protein mRNA gc (1-1273)(K986P_V987P_BA.1_v3)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28935 - RNA, 4091 nt, Artificial Sequence
  SARS-CoV-2/Wuhan/WIV05/2019__EPI_ISL_402128 spike protein mRNA gc (1-1273)(K986P_V987P_BA.1_v4)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28936 - RNA, 4091 nt, Artificial Sequence
  SARS-CoV-2/Wuhan/WIV05/2019__EPI_ISL_402128 spike protein mRNA gc (1-1273)(K986P_V987P_BA.1_v5)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucagcggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28937 - RNA, 4067 nt, Artificial Sequence
  SARS-CoV-2/Wuhan/WIV05/2019__EPI_ISL_402128 spike protein mRNA gc (1-1273)(K986P_V987P_BA.1_v2)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaagcucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28938 - RNA, 4067 nt, Artificial Sequence
  SARS-CoV-2/Wuhan/WIV05/2019__EPI_ISL_402128 spike protein mRNA gc (1-1273)(K986P_V987P_BA.1_v3)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28939 - RNA, 4067 nt, Artificial Sequence
  SARS-CoV-2/Wuhan/WIV05/2019__EPI_ISL_402128 spike protein mRNA gc (1-1273)(K986P_V987P_BA.1_v4)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28940 - RNA, 4067 nt, Artificial Sequence
  SARS-CoV-2/Wuhan/WIV05/2019__EPI_ISL_402128 spike protein mRNA gc (1-1273)(K986P_V987P_BA.1_v5)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucgaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaucguccgggagcccgaggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucgacgagguguucaacgccacccgguucgccagcgucuacgccuggaaccgcaagcggaucuccaacugcguggcggacuacagcgugcuguacaaccuggcccccuucuucacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucagcggcaacuacaacuaccuguaccgccuguuccgcaagagcaaccucaagcccuucgagcgggacaucuccaccgagaucuaccaggccggcaacaagcccugcaacgggguggccggcuucaacugcuacuucccccugcgcuccuacagcuuccgcccgaccuacggcguggggcaccagcccuaccggguggucgugcugagcuucgagcuccugcacgcccccgccacggugugcggccccaagaaguccaccaaccuggucaagaacaagugcgugaacuucaacuucaacggccucaaggggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaagucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaagcgcgcgcugacggggaucgccguggagcaggacaagaacacccaggagguguucgcccaggucaagcagaucuacaagacgcccccgaucaaguacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaagggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccacaacgcccaggcccugaacacgcucgugaagcagcuguccagcaaguucggcgccaucuccagcgugcugaacgacaucuucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaugaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa
